United States Patent 12,091,435 (ANTIBODY-EVADING VIRUS VECTORS) - sequence listing, part 2

SEQ ID NO: 2548 - protein, 736 aa, Artificial sequence
  Recombinant AAV capsid
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTELGSYEGSQTLKFSVAGPSNMAVQGRNYIPGPSYRQQRVSSAVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPRSTFNGDKLNSFITQYSTGQVTVKIDWELQKENSKRWNPEIQYTSNYYKSNNVEFAVNTEGVYSEPRPIGTRYLTRNL

SEQ ID NO: 2549 - protein, 736 aa, Artificial sequence
  Recombinant AAV capsid
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTELGSYEGSQTLKFSVAGPSNMAVQGRNYIPGPSYRQQRVSSAVTQNNNSEFAWPGASSWALNGRNSLMNPGPAMASHKEGEDRFFPLSGSLIFGKQGTGRDNVDADKVMITNEEEIKTTNPVATESYGQVATNHQSTIDDSLSYWVQNQGILPGMVWQDRDVYLQGPIWAKIPHTDGNFHPSPLMGGFGMKHPPPQILIKNTPVPADPRSTFNGDKLNSFITQYSTGQVTVKIDWELQKENSKRWNPEIQYTSNYYKSNNVEFAVNTEGVYSEPRPIGTRYLTRNL

SEQ ID NO: 2550 - protein, 736 aa, Artificial sequence
  Recombinant AAV capsid
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTELGSYEGSQTLKFSVAGPSNMAVQGRNYIPGPSYRQQRVSSAVTQNNNSEFAWPGASSWALNGRNSLMNPGPAMASHKEGEDRFFPLSGSLIFGKQGTGRDNVDADKVMITNEEEIKTTNPVATESYGQVATNHQSMSAEPIAIWVQNQGILPGMVWQDRDVYLQGPIWAKIPHTDGNFHPSPLMGGFGMKHPPPQILIKNTPVPADPRSTFNGDKLNSFITQYSTGQVTVKIDWELQKENSKRWNPEIQYTSNYYKSNNVEFAVNTEGVYSEPRPIGTRYLTRNL

SEQ ID NO: 2551 - protein, 736 aa, Artificial sequence
  Recombinant AAV capsid
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTELGSYEGSQTLKFSVAGPSNMAVQGRNYIPGPSYRQQRVSSAVTQNNNSEFAWPGASSWALNGRNSLMNPGPAMASHKEGEDRFFPLSGSLIFGKQGTGRDNVDADKVMITNEEEIKTTNPVATESYGQVATNHQSSKVESWTEWVQNQGILPGMVWQDRDVYLQGPIWAKIPHTDGNFHPSPLMGGFGMKHPPPQILIKNTPVPADPRSTFNGDKLNSFITQYSTGQVTVKIDWELQKENSKRWNPEIQYTSNYYKSNNVEFAVNTEGVYSEPRPIGTRYLTRNL

SEQ ID NO: 2552 - protein, 736 aa, Artificial sequence
  Recombinant AAV capsid
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTELGSYEGSQTLKFSVAGPSNMAVQGRNYIPGPSYRQQRVSSAVTQNNNSEFAWPGASSWALNGRNSLMNPGPAMASHKEGEDRFFPLSGSLIFGKQGTGRDNVDADKVMITNEEEIKTTNPVATESYGQVATNHQSSTVDSIAIWVQNQGILPGMVWQDRDVYLQGPIWAKIPHTDGNFHPSPLMGGFGMKHPPPQILIKNTPVPADPRSTFNGDKLNSFITQYSTGQVTVKIDWELQKENSKRWNPEIQYTSNYYKSNNVEFAVNTEGVYSEPRPIGTRYLTRNL

SEQ ID NO: 2553 - protein, 736 aa, Artificial sequence
  Recombinant AAV capsid
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTELGSYEGSQTLKFSVAGPSNMAVQGRNYIPGPSYRQQRVSSAVTQNNNSEFAWPGASSWALNGRNSLMNPGPAMASHKEGEDRFFPLSGSLIFGKQGTGRDNVDADKVMITNEEEIKTTNPVATESYGQVATNHQSRDYEAWSQWVQNQGILPGMVWQDRDVYLQGPIWAKIPHTDGNFHPSPLMGGFGMKHPPPQILIKNTPVPADPRSTFNGDKLNSFITQYSTGQVTVKIDWELQKENSKRWNPEIQYTSNYYKSNNVEFAVNTEGVYSEPRPIGTRYLTRNL

SEQ ID NO: 2554 - protein, 736 aa, Artificial sequence
  Recombinant AAV capsid
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTELGSYEGSQTLKFSVAGPSNMAVQGRNYIPGPSYRQQRVSASVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPRSTFNGDKLNSFITQYSTGQVTVKIDWELQKENSKRWNPEIQYTSNYYKSNNVEFAVNTEGVYSEPRPIGTRYLTRNL

SEQ ID NO: 2555 - protein, 736 aa, Artificial sequence
  Recombinant AAV capsid
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTELGSYEGSQTLKFSVAGPSNMAVQGRNYIPGPSYRQQRVSASVTQNNNSEFAWPGASSWALNGRNSLMNPGPAMASHKEGEDRFFPLSGSLIFGKQGTGRDNVDADKVMITNEEEIKTTNPVATESYGQVATNHQSTIDDSLSYWVQNQGILPGMVWQDRDVYLQGPIWAKIPHTDGNFHPSPLMGGFGMKHPPPQILIKNTPVPADPRSTFNGDKLNSFITQYSTGQVTVKIDWELQKENSKRWNPEIQYTSNYYKSNNVEFAVNTEGVYSEPRPIGTRYLTRNL

SEQ ID NO: 2556 - protein, 736 aa, Artificial sequence
  Recombinant AAV capsid
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTELGSYEGSQTLKFSVAGPSNMAVQGRNYIPGPSYRQQRVSASVTQNNNSEFAWPGASSWALNGRNSLMNPGPAMASHKEGEDRFFPLSGSLIFGKQGTGRDNVDADKVMITNEEEIKTTNPVATESYGQVATNHQSMSAEPIAIWVQNQGILPGMVWQDRDVYLQGPIWAKIPHTDGNFHPSPLMGGFGMKHPPPQILIKNTPVPADPRSTFNGDKLNSFITQYSTGQVTVKIDWELQKENSKRWNPEIQYTSNYYKSNNVEFAVNTEGVYSEPRPIGTRYLTRNL

SEQ ID NO: 2557 - protein, 736 aa, Artificial sequence
  Recombinant AAV capsid
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTELGSYEGSQTLKFSVAGPSNMAVQGRNYIPGPSYRQQRVSASVTQNNNSEFAWPGASSWALNGRNSLMNPGPAMASHKEGEDRFFPLSGSLIFGKQGTGRDNVDADKVMITNEEEIKTTNPVATESYGQVATNHQSSKVESWTEWVQNQGILPGMVWQDRDVYLQGPIWAKIPHTDGNFHPSPLMGGFGMKHPPPQILIKNTPVPADPRSTFNGDKLNSFITQYSTGQVTVKIDWELQKENSKRWNPEIQYTSNYYKSNNVEFAVNTEGVYSEPRPIGTRYLTRNL

SEQ ID NO: 2558 - protein, 736 aa, Artificial sequence
  Recombinant AAV capsid
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTELGSYEGSQTLKFSVAGPSNMAVQGRNYIPGPSYRQQRVSASVTQNNNSEFAWPGASSWALNGRNSLMNPGPAMASHKEGEDRFFPLSGSLIFGKQGTGRDNVDADKVMITNEEEIKTTNPVATESYGQVATNHQSSTVDSIAIWVQNQGILPGMVWQDRDVYLQGPIWAKIPHTDGNFHPSPLMGGFGMKHPPPQILIKNTPVPADPRSTFNGDKLNSFITQYSTGQVTVKIDWELQKENSKRWNPEIQYTSNYYKSNNVEFAVNTEGVYSEPRPIGTRYLTRNL

SEQ ID NO: 2559 - protein, 736 aa, Artificial sequence
  Recombinant AAV capsid
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTELGSYEGSQTLKFSVAGPSNMAVQGRNYIPGPSYRQQRVSASVTQNNNSEFAWPGASSWALNGRNSLMNPGPAMASHKEGEDRFFPLSGSLIFGKQGTGRDNVDADKVMITNEEEIKTTNPVATESYGQVATNHQSRDYEAWSQWVQNQGILPGMVWQDRDVYLQGPIWAKIPHTDGNFHPSPLMGGFGMKHPPPQILIKNTPVPADPRSTFNGDKLNSFITQYSTGQVTVKIDWELQKENSKRWNPEIQYTSNYYKSNNVEFAVNTEGVYSEPRPIGTRYLTRNL

SEQ ID NO: 2560 - protein, 736 aa, Artificial sequence
  Recombinant AAV capsid
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKKLKFTLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTELGSYEGSQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPRSTFNGDKLNSFITQYSTGQVTVKIDWELQKENSKRWNPEIQYTSNYYKSNNVEFAVNTEGVYSEPRPIGTRYLTRNL

SEQ ID NO: 2561 - protein, 736 aa, Artificial sequence
  Recombinant AAV capsid
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKKLKFTLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTELGSYEGSQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSTIDDSLSYWVQNQGILPGMVWQDRDVYLQGPIWAKIPHTDGNFHPSPLMGGFGMKHPPPQILIKNTPVPADPRSTFNGDKLNSFITQYSTGQVTVKIDWELQKENSKRWNPEIQYTSNYYKSNNVEFAVNTEGVYSEPRPIGTRYLTRNL

SEQ ID NO: 2562 - protein, 736 aa, Artificial sequence
  Recombinant AAV capsid
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKKLKFTLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTELGSYEGSQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSMSAEPIAIWVQNQGILPGMVWQDRDVYLQGPIWAKIPHTDGNFHPSPLMGGFGMKHPPPQILIKNTPVPADPRSTFNGDKLNSFITQYSTGQVTVKIDWELQKENSKRWNPEIQYTSNYYKSNNVEFAVNTEGVYSEPRPIGTRYLTRNL

SEQ ID NO: 2563 - protein, 736 aa, Artificial sequence
  Recombinant AAV capsid
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKKLKFTLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTELGSYEGSQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSSKVESWTEWVQNQGILPGMVWQDRDVYLQGPIWAKIPHTDGNFHPSPLMGGFGMKHPPPQILIKNTPVPADPRSTFNGDKLNSFITQYSTGQVTVKIDWELQKENSKRWNPEIQYTSNYYKSNNVEFAVNTEGVYSEPRPIGTRYLTRNL

SEQ ID NO: 2564 - protein, 736 aa, Artificial sequence
  Recombinant AAV capsid
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKKLKFTLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTELGSYEGSQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSSTVDSIAIWVQNQGILPGMVWQDRDVYLQGPIWAKIPHTDGNFHPSPLMGGFGMKHPPPQILIKNTPVPADPRSTFNGDKLNSFITQYSTGQVTVKIDWELQKENSKRWNPEIQYTSNYYKSNNVEFAVNTEGVYSEPRPIGTRYLTRNL

SEQ ID NO: 2565 - protein, 736 aa, Artificial sequence
  Recombinant AAV capsid
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKKLKFTLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTELGSYEGSQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSRDYEAWSQWVQNQGILPGMVWQDRDVYLQGPIWAKIPHTDGNFHPSPLMGGFGMKHPPPQILIKNTPVPADPRSTFNGDKLNSFITQYSTGQVTVKIDWELQKENSKRWNPEIQYTSNYYKSNNVEFAVNTEGVYSEPRPIGTRYLTRNL

SEQ ID NO: 2566 - protein, 736 aa, Artificial sequence
  Recombinant AAV capsid
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKKLKFTLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTELGSYEGSQTLKFSVAGPSNMAVQGRNYIPGPSYRQQRVSSSVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPRSTFNGDKLNSFITQYSTGQVTVKIDWELQKENSKRWNPEIQYTSNYYKSNNVEFAVNTEGVYSEPRPIGTRYLTRNL

SEQ ID NO: 2567 - protein, 736 aa, Artificial sequence
  Recombinant AAV capsid
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKKLKFTLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTELGSYEGSQTLKFSVAGPSNMAVQGRNYIPGPSYRQQRVSSSVTQNNNSEFAWPGASSWALNGRNSLMNPGPAMASHKEGEDRFFPLSGSLIFGKQGTGRDNVDADKVMITNEEEIKTTNPVATESYGQVATNHQSTIDDSLSYWVQNQGILPGMVWQDRDVYLQGPIWAKIPHTDGNFHPSPLMGGFGMKHPPPQILIKNTPVPADPRSTFNGDKLNSFITQYSTGQVTVKIDWELQKENSKRWNPEIQYTSNYYKSNNVEFAVNTEGVYSEPRPIGTRYLTRNL

SEQ ID NO: 2568 - protein, 736 aa, Artificial sequence
  Recombinant AAV capsid
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKKLKFTLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTELGSYEGSQTLKFSVAGPSNMAVQGRNYIPGPSYRQQRVSSSVTQNNNSEFAWPGASSWALNGRNSLMNPGPAMASHKEGEDRFFPLSGSLIFGKQGTGRDNVDADKVMITNEEEIKTTNPVATESYGQVATNHQSMSAEPIAIWVQNQGILPGMVWQDRDVYLQGPIWAKIPHTDGNFHPSPLMGGFGMKHPPPQILIKNTPVPADPRSTFNGDKLNSFITQYSTGQVTVKIDWELQKENSKRWNPEIQYTSNYYKSNNVEFAVNTEGVYSEPRPIGTRYLTRNL

SEQ ID NO: 2569 - protein, 736 aa, Artificial sequence
  Recombinant AAV capsid
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKKLKFTLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTELGSYEGSQTLKFSVAGPSNMAVQGRNYIPGPSYRQQRVSSSVTQNNNSEFAWPGASSWALNGRNSLMNPGPAMASHKEGEDRFFPLSGSLIFGKQGTGRDNVDADKVMITNEEEIKTTNPVATESYGQVATNHQSSKVESWTEWVQNQGILPGMVWQDRDVYLQGPIWAKIPHTDGNFHPSPLMGGFGMKHPPPQILIKNTPVPADPRSTFNGDKLNSFITQYSTGQVTVKIDWELQKENSKRWNPEIQYTSNYYKSNNVEFAVNTEGVYSEPRPIGTRYLTRNL

SEQ ID NO: 2570 - protein, 736 aa, Artificial sequence
  Recombinant AAV capsid
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKKLKFTLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTELGSYEGSQTLKFSVAGPSNMAVQGRNYIPGPSYRQQRVSSSVTQNNNSEFAWPGASSWALNGRNSLMNPGPAMASHKEGEDRFFPLSGSLIFGKQGTGRDNVDADKVMITNEEEIKTTNPVATESYGQVATNHQSSTVDSIAIWVQNQGILPGMVWQDRDVYLQGPIWAKIPHTDGNFHPSPLMGGFGMKHPPPQILIKNTPVPADPRSTFNGDKLNSFITQYSTGQVTVKIDWELQKENSKRWNPEIQYTSNYYKSNNVEFAVNTEGVYSEPRPIGTRYLTRNL

SEQ ID NO: 2571 - protein, 736 aa, Artificial sequence
  Recombinant AAV capsid
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKKLKFTLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTELGSYEGSQTLKFSVAGPSNMAVQGRNYIPGPSYRQQRVSSSVTQNNNSEFAWPGASSWALNGRNSLMNPGPAMASHKEGEDRFFPLSGSLIFGKQGTGRDNVDADKVMITNEEEIKTTNPVATESYGQVATNHQSRDYEAWSQWVQNQGILPGMVWQDRDVYLQGPIWAKIPHTDGNFHPSPLMGGFGMKHPPPQILIKNTPVPADPRSTFNGDKLNSFITQYSTGQVTVKIDWELQKENSKRWNPEIQYTSNYYKSNNVEFAVNTEGVYSEPRPIGTRYLTRNL

SEQ ID NO: 2572 - protein, 736 aa, Artificial sequence
  Recombinant AAV capsid
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKKLKFTLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTELGSYEGSQTLKFSVAGPSNMAVQGRNYIPGPSYRQQRVSAAVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPRSTFNGDKLNSFITQYSTGQVTVKIDWELQKENSKRWNPEIQYTSNYYKSNNVEFAVNTEGVYSEPRPIGTRYLTRNL

SEQ ID NO: 2573 - protein, 736 aa, Artificial sequence
  Recombinant AAV capsid
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKKLKFTLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTELGSYEGSQTLKFSVAGPSNMAVQGRNYIPGPSYRQQRVSAAVTQNNNSEFAWPGASSWALNGRNSLMNPGPAMASHKEGEDRFFPLSGSLIFGKQGTGRDNVDADKVMITNEEEIKTTNPVATESYGQVATNHQSTIDDSLSYWVQNQGILPGMVWQDRDVYLQGPIWAKIPHTDGNFHPSPLMGGFGMKHPPPQILIKNTPVPADPRSTFNGDKLNSFITQYSTGQVTVKIDWELQKENSKRWNPEIQYTSNYYKSNNVEFAVNTEGVYSEPRPIGTRYLTRNL

SEQ ID NO: 2574 - protein, 736 aa, Artificial sequence
  Recombinant AAV capsid
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKKLKFTLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTELGSYEGSQTLKFSVAGPSNMAVQGRNYIPGPSYRQQRVSAAVTQNNNSEFAWPGASSWALNGRNSLMNPGPAMASHKEGEDRFFPLSGSLIFGKQGTGRDNVDADKVMITNEEEIKTTNPVATESYGQVATNHQSMSAEPIAIWVQNQGILPGMVWQDRDVYLQGPIWAKIPHTDGNFHPSPLMGGFGMKHPPPQILIKNTPVPADPRSTFNGDKLNSFITQYSTGQVTVKIDWELQKENSKRWNPEIQYTSNYYKSNNVEFAVNTEGVYSEPRPIGTRYLTRNL

SEQ ID NO: 2575 - protein, 736 aa, Artificial sequence
  Recombinant AAV capsid
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKKLKFTLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTELGSYEGSQTLKFSVAGPSNMAVQGRNYIPGPSYRQQRVSAAVTQNNNSEFAWPGASSWALNGRNSLMNPGPAMASHKEGEDRFFPLSGSLIFGKQGTGRDNVDADKVMITNEEEIKTTNPVATESYGQVATNHQSSKVESWTEWVQNQGILPGMVWQDRDVYLQGPIWAKIPHTDGNFHPSPLMGGFGMKHPPPQILIKNTPVPADPRSTFNGDKLNSFITQYSTGQVTVKIDWELQKENSKRWNPEIQYTSNYYKSNNVEFAVNTEGVYSEPRPIGTRYLTRNL

SEQ ID NO: 2576 - protein, 736 aa, Artificial sequence
  Recombinant AAV capsid
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKKLKFTLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTELGSYEGSQTLKFSVAGPSNMAVQGRNYIPGPSYRQQRVSAAVTQNNNSEFAWPGASSWALNGRNSLMNPGPAMASHKEGEDRFFPLSGSLIFGKQGTGRDNVDADKVMITNEEEIKTTNPVATESYGQVATNHQSSTVDSIAIWVQNQGILPGMVWQDRDVYLQGPIWAKIPHTDGNFHPSPLMGGFGMKHPPPQILIKNTPVPADPRSTFNGDKLNSFITQYSTGQVTVKIDWELQKENSKRWNPEIQYTSNYYKSNNVEFAVNTEGVYSEPRPIGTRYLTRNL

SEQ ID NO: 2577 - protein, 736 aa, Artificial sequence
  Recombinant AAV capsid
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKKLKFTLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTELGSYEGSQTLKFSVAGPSNMAVQGRNYIPGPSYRQQRVSAAVTQNNNSEFAWPGASSWALNGRNSLMNPGPAMASHKEGEDRFFPLSGSLIFGKQGTGRDNVDADKVMITNEEEIKTTNPVATESYGQVATNHQSRDYEAWSQWVQNQGILPGMVWQDRDVYLQGPIWAKIPHTDGNFHPSPLMGGFGMKHPPPQILIKNTPVPADPRSTFNGDKLNSFITQYSTGQVTVKIDWELQKENSKRWNPEIQYTSNYYKSNNVEFAVNTEGVYSEPRPIGTRYLTRNL

SEQ ID NO: 2578 - protein, 736 aa, Artificial sequence
  Recombinant AAV capsid
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKKLKFTLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTELGSYEGSQTLKFSVAGPSNMAVQGRNYIPGPSYRQQRVSSAVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPRSTFNGDKLNSFITQYSTGQVTVKIDWELQKENSKRWNPEIQYTSNYYKSNNVEFAVNTEGVYSEPRPIGTRYLTRNL

SEQ ID NO: 2579 - protein, 736 aa, Artificial sequence
  Recombinant AAV capsid
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKKLKFTLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTELGSYEGSQTLKFSVAGPSNMAVQGRNYIPGPSYRQQRVSSAVTQNNNSEFAWPGASSWALNGRNSLMNPGPAMASHKEGEDRFFPLSGSLIFGKQGTGRDNVDADKVMITNEEEIKTTNPVATESYGQVATNHQSTIDDSLSYWVQNQGILPGMVWQDRDVYLQGPIWAKIPHTDGNFHPSPLMGGFGMKHPPPQILIKNTPVPADPRSTFNGDKLNSFITQYSTGQVTVKIDWELQKENSKRWNPEIQYTSNYYKSNNVEFAVNTEGVYSEPRPIGTRYLTRNL

SEQ ID NO: 2580 - protein, 736 aa, Artificial sequence
  Recombinant AAV capsid
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKKLKFTLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTELGSYEGSQTLKFSVAGPSNMAVQGRNYIPGPSYRQQRVSSAVTQNNNSEFAWPGASSWALNGRNSLMNPGPAMASHKEGEDRFFPLSGSLIFGKQGTGRDNVDADKVMITNEEEIKTTNPVATESYGQVATNHQSMSAEPIAIWVQNQGILPGMVWQDRDVYLQGPIWAKIPHTDGNFHPSPLMGGFGMKHPPPQILIKNTPVPADPRSTFNGDKLNSFITQYSTGQVTVKIDWELQKENSKRWNPEIQYTSNYYKSNNVEFAVNTEGVYSEPRPIGTRYLTRNL

SEQ ID NO: 2581 - protein, 736 aa, Artificial sequence
  Recombinant AAV capsid
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKKLKFTLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTELGSYEGSQTLKFSVAGPSNMAVQGRNYIPGPSYRQQRVSSAVTQNNNSEFAWPGASSWALNGRNSLMNPGPAMASHKEGEDRFFPLSGSLIFGKQGTGRDNVDADKVMITNEEEIKTTNPVATESYGQVATNHQSSKVESWTEWVQNQGILPGMVWQDRDVYLQGPIWAKIPHTDGNFHPSPLMGGFGMKHPPPQILIKNTPVPADPRSTFNGDKLNSFITQYSTGQVTVKIDWELQKENSKRWNPEIQYTSNYYKSNNVEFAVNTEGVYSEPRPIGTRYLTRNL

SEQ ID NO: 2582 - protein, 736 aa, Artificial sequence
  Recombinant AAV capsid
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKKLKFTLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTELGSYEGSQTLKFSVAGPSNMAVQGRNYIPGPSYRQQRVSSAVTQNNNSEFAWPGASSWALNGRNSLMNPGPAMASHKEGEDRFFPLSGSLIFGKQGTGRDNVDADKVMITNEEEIKTTNPVATESYGQVATNHQSSTVDSIAIWVQNQGILPGMVWQDRDVYLQGPIWAKIPHTDGNFHPSPLMGGFGMKHPPPQILIKNTPVPADPRSTFNGDKLNSFITQYSTGQVTVKIDWELQKENSKRWNPEIQYTSNYYKSNNVEFAVNTEGVYSEPRPIGTRYLTRNL

SEQ ID NO: 2583 - protein, 736 aa, Artificial sequence
  Recombinant AAV capsid
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKKLKFTLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTELGSYEGSQTLKFSVAGPSNMAVQGRNYIPGPSYRQQRVSSAVTQNNNSEFAWPGASSWALNGRNSLMNPGPAMASHKEGEDRFFPLSGSLIFGKQGTGRDNVDADKVMITNEEEIKTTNPVATESYGQVATNHQSRDYEAWSQWVQNQGILPGMVWQDRDVYLQGPIWAKIPHTDGNFHPSPLMGGFGMKHPPPQILIKNTPVPADPRSTFNGDKLNSFITQYSTGQVTVKIDWELQKENSKRWNPEIQYTSNYYKSNNVEFAVNTEGVYSEPRPIGTRYLTRNL

SEQ ID NO: 2584 - protein, 736 aa, Artificial sequence
  Recombinant AAV capsid
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKKLKFTLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTELGSYEGSQTLKFSVAGPSNMAVQGRNYIPGPSYRQQRVSASVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPRSTFNGDKLNSFITQYSTGQVTVKIDWELQKENSKRWNPEIQYTSNYYKSNNVEFAVNTEGVYSEPRPIGTRYLTRNL

SEQ ID NO: 2585 - protein, 736 aa, Artificial sequence
  Recombinant AAV capsid
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKKLKFTLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTELGSYEGSQTLKFSVAGPSNMAVQGRNYIPGPSYRQQRVSASVTQNNNSEFAWPGASSWALNGRNSLMNPGPAMASHKEGEDRFFPLSGSLIFGKQGTGRDNVDADKVMITNEEEIKTTNPVATESYGQVATNHQSTIDDSLSYWVQNQGILPGMVWQDRDVYLQGPIWAKIPHTDGNFHPSPLMGGFGMKHPPPQILIKNTPVPADPRSTFNGDKLNSFITQYSTGQVTVKIDWELQKENSKRWNPEIQYTSNYYKSNNVEFAVNTEGVYSEPRPIGTRYLTRNL

SEQ ID NO: 2586 - protein, 736 aa, Artificial sequence
  Recombinant AAV capsid
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKKLKFTLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTELGSYEGSQTLKFSVAGPSNMAVQGRNYIPGPSYRQQRVSASVTQNNNSEFAWPGASSWALNGRNSLMNPGPAMASHKEGEDRFFPLSGSLIFGKQGTGRDNVDADKVMITNEEEIKTTNPVATESYGQVATNHQSMSAEPIAIWVQNQGILPGMVWQDRDVYLQGPIWAKIPHTDGNFHPSPLMGGFGMKHPPPQILIKNTPVPADPRSTFNGDKLNSFITQYSTGQVTVKIDWELQKENSKRWNPEIQYTSNYYKSNNVEFAVNTEGVYSEPRPIGTRYLTRNL

SEQ ID NO: 2587 - protein, 736 aa, Artificial sequence
  Recombinant AAV capsid
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKKLKFTLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTELGSYEGSQTLKFSVAGPSNMAVQGRNYIPGPSYRQQRVSASVTQNNNSEFAWPGASSWALNGRNSLMNPGPAMASHKEGEDRFFPLSGSLIFGKQGTGRDNVDADKVMITNEEEIKTTNPVATESYGQVATNHQSSKVESWTEWVQNQGILPGMVWQDRDVYLQGPIWAKIPHTDGNFHPSPLMGGFGMKHPPPQILIKNTPVPADPRSTFNGDKLNSFITQYSTGQVTVKIDWELQKENSKRWNPEIQYTSNYYKSNNVEFAVNTEGVYSEPRPIGTRYLTRNL

SEQ ID NO: 2588 - protein, 736 aa, Artificial sequence
  Recombinant AAV capsid
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKKLKFTLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTELGSYEGSQTLKFSVAGPSNMAVQGRNYIPGPSYRQQRVSASVTQNNNSEFAWPGASSWALNGRNSLMNPGPAMASHKEGEDRFFPLSGSLIFGKQGTGRDNVDADKVMITNEEEIKTTNPVATESYGQVATNHQSSTVDSIAIWVQNQGILPGMVWQDRDVYLQGPIWAKIPHTDGNFHPSPLMGGFGMKHPPPQILIKNTPVPADPRSTFNGDKLNSFITQYSTGQVTVKIDWELQKENSKRWNPEIQYTSNYYKSNNVEFAVNTEGVYSEPRPIGTRYLTRNL

SEQ ID NO: 2589 - protein, 736 aa, Artificial sequence
  Recombinant AAV capsid
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKKLKFTLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTELGSYEGSQTLKFSVAGPSNMAVQGRNYIPGPSYRQQRVSASVTQNNNSEFAWPGASSWALNGRNSLMNPGPAMASHKEGEDRFFPLSGSLIFGKQGTGRDNVDADKVMITNEEEIKTTNPVATESYGQVATNHQSRDYEAWSQWVQNQGILPGMVWQDRDVYLQGPIWAKIPHTDGNFHPSPLMGGFGMKHPPPQILIKNTPVPADPRSTFNGDKLNSFITQYSTGQVTVKIDWELQKENSKRWNPEIQYTSNYYKSNNVEFAVNTEGVYSEPRPIGTRYLTRNL

SEQ ID NO: 2590 - protein, 8 aa, Artificial sequence
  Recombinant AAV capsid
SENGDLAT

SEQ ID NO: 2591 - protein, 7 aa, Parvovirus Adeno-associated virus
SASTGAS

SEQ ID NO: 2592 - protein, 10 aa, Parvovirus Adeno-associated virus
VFMIPQYGYL

SEQ ID NO: 2593 - protein, 9 aa, Parvovirus Adeno-associated virus
NQSGSAQNK

SEQ ID NO: 2594 - protein, 2 aa, Parvovirus Adeno-associated virus
SV

SEQ ID NO: 2595 - protein, 8 aa, Parvovirus Adeno-associated virus
KTDNNNSN

SEQ ID NO: 2596 - protein, 7 aa, Parvovirus Adeno-associated virus
KDDEDKF

SEQ ID NO: 2597 - protein, 6 aa, Parvovirus Adeno-associated virus
SAGASN

SEQ ID NO: 2598 - protein, 10 aa, Parvovirus Adeno-associated virus
STDPATGDVH

SEQ ID NO: 2599 - protein, 2 aa, Parvovirus Adeno-associated virus
AN

SEQ ID NO: 2600 - protein, 7 aa, Parvovirus Adeno-associated virus
DNNGLYT

SEQ ID NO: 2601 - protein, 6 aa, Parvovirus Adeno-associated virus
SQSGAS

SEQ ID NO: 2602 - protein, 10 aa, Parvovirus Adeno-associated virus
VFMVPQYGYL

SEQ ID NO: 2603 - protein, 9 aa, Parvovirus Adeno-associated virus
TPSGTTTQS

SEQ ID NO: 2604 - protein, 2 aa, Parvovirus Adeno-associated virus
RD

SEQ ID NO: 2605 - protein, 8 aa, Parvovirus Adeno-associated virus
SADNNNSE

SEQ ID NO: 2606 - protein, 7 aa, Parvovirus Adeno-associated virus
KDDEEKF

SEQ ID NO: 2607 - protein, 6 aa, Parvovirus Adeno-associated virus
GSEKTN

SEQ ID NO: 2608 - protein, 10 aa, Parvovirus Adeno-associated virus
NRQAATADVN

SEQ ID NO: 2609 - protein, 2 aa, Parvovirus Adeno-associated virus
VN

SEQ ID NO: 2610 - protein, 7 aa, Parvovirus Adeno-associated virus
DTNGVYS

SEQ ID NO: 2611 - protein, 6 aa, Parvovirus Adeno-associated virus
SQSGAS

SEQ ID NO: 2612 - protein, 10 aa, Parvovirus Adeno-associated virus
VFMVPQYGYL

SEQ ID NO: 2613 - protein, 9 aa, Parvovirus Adeno-associated virus
TTSGTTNQS

SEQ ID NO: 2614 - protein, 2 aa, Parvovirus Adeno-associated virus
SL

SEQ ID NO: 2615 - protein, 8 aa, Parvovirus Adeno-associated virus
ANDNNNSN

SEQ ID NO: 2616 - protein, 7 aa, Parvovirus Adeno-associated virus
KDDEEKF

SEQ ID NO: 2617 - protein, 6 aa, Parvovirus Adeno-associated virus
GTTASN

SEQ ID NO: 2618 - protein, 10 aa, Parvovirus Adeno-associated virus
NTAPTTGTVN

SEQ ID NO: 2619 - protein, 2 aa, Parvovirus Adeno-associated virus
VN

SEQ ID NO: 2620 - protein, 7 aa, Parvovirus Adeno-associated virus
DTNGVYS

SEQ ID NO: 2621 - protein, 8 aa, Parvovirus Adeno-associated virus
RLGESLQS

SEQ ID NO: 2622 - protein, 10 aa, Parvovirus Adeno-associated virus
VFMVPQYGYC

SEQ ID NO: 2623 - protein, 9 aa, Parvovirus Adeno-associated virus
GTTLNAGTA

SEQ ID NO: 2624 - protein, 2 aa, Parvovirus Adeno-associated virus
SN

SEQ ID NO: 2625 - protein, 12 aa, Parvovirus Adeno-associated virus
ANQNYKIPATGS

SEQ ID NO: 2626 - protein, 7 aa, Parvovirus Adeno-associated virus
GPADSKF

SEQ ID NO: 2627 - protein, 6 aa, Parvovirus Adeno-associated virus
QNGNTA

SEQ ID NO: 2628 - protein, 10 aa, Parvovirus Adeno-associated virus
SNLPTVDRLT

SEQ ID NO: 2629 - protein, 2 aa, Parvovirus Adeno-associated virus
NS

SEQ ID NO: 2630 - protein, 7 aa, Parvovirus Adeno-associated virus
DAAGKYT

SEQ ID NO: 2631 - protein, 10 aa, Parvovirus Adeno-associated virus
EIKSGSVDGS

SEQ ID NO: 2632 - protein, 10 aa, Parvovirus Adeno-associated virus
VFTLPQYGYA

SEQ ID NO: 2633 - protein, 9 aa, Parvovirus Adeno-associated virus
STNNTGGVQ

SEQ ID NO: 2634 - protein, 2 aa, Parvovirus Adeno-associated virus
AN

SEQ ID NO: 2635 - protein, 7 aa, Parvovirus Adeno-associated virus
SGVNRAS

SEQ ID NO: 2636 - protein, 7 aa, Parvovirus Adeno-associated virus
LQGSNTY

SEQ ID NO: 2637 - protein, 8 aa, Parvovirus Adeno-associated virus
ANPGTTAT

SEQ ID NO: 2638 - protein, 10 aa, Parvovirus Adeno-associated virus
TTAPATGTYN

SEQ ID NO: 2639 - protein, 2 aa, Parvovirus Adeno-associated virus
QF

SEQ ID NO: 2640 - protein, 7 aa, Parvovirus Adeno-associated virus
DSTGEYR

SEQ ID NO: 2641 - protein, 7 aa, Parvovirus Adeno-associated virus
SASTGAS

SEQ ID NO: 2642 - protein, 10 aa, Parvovirus Adeno-associated virus
VFMIPQYGYL

SEQ ID NO: 2643 - protein, 9 aa, Parvovirus Adeno-associated virus
NQSGSAQNK

SEQ ID NO: 2644 - protein, 2 aa, Parvovirus Adeno-associated virus
SV

SEQ ID NO: 2645 - protein, 8 aa, Parvovirus Adeno-associated virus
KTDNNNSN

SEQ ID NO: 2646 - protein, 7 aa, Parvovirus Adeno-associated virus
KDDKDKF

SEQ ID NO: 2647 - protein, 6 aa, Parvovirus Adeno-associated virus
SAGASN

SEQ ID NO: 2648 - protein, 10 aa, Parvovirus Adeno-associated virus
STDPATGDVH

SEQ ID NO: 2649 - protein, 2 aa, Parvovirus Adeno-associated virus
AN

SEQ ID NO: 2650 - protein, 7 aa, Parvovirus Adeno-associated virus
DNNGLYT

SEQ ID NO: 2651 - protein, 7 aa, Parvovirus Adeno-associated virus
SETAGST

SEQ ID NO: 2652 - protein, 10 aa, Parvovirus Adeno-associated virus
VFMIPQYGYL

SEQ ID NO: 2653 - protein, 9 aa, Parvovirus Adeno-associated virus
NPGGTAGNR

SEQ ID NO: 2654 - protein, 2 aa, Parvovirus Adeno-associated virus
AN

SEQ ID NO: 2655 - protein, 8 aa, Parvovirus Adeno-associated virus
LDQNNNSN

SEQ ID NO: 2656 - protein, 7 aa, Parvovirus Adeno-associated virus
KDDEDRF

SEQ ID NO: 2657 - protein, 6 aa, Parvovirus Adeno-associated virus
GATNKT

SEQ ID NO: 2658 - protein, 10 aa, Parvovirus Adeno-associated virus
NTAAQTQVVN

SEQ ID NO: 2659 - protein, 2 aa, Parvovirus Adeno-associated virus
TG

SEQ ID NO: 2660 - protein, 7 aa, Parvovirus Adeno-associated virus
DSQGVYS

SEQ ID NO: 2661 - protein, 8 aa, Parvovirus Adeno-associated virus
NGTSGGAT

SEQ ID NO: 2662 - protein, 10 aa, Parvovirus Adeno-associated virus
VFMIPQYGYL

SEQ ID NO: 2663 - protein, 9 aa, Parvovirus Adeno-associated virus
TTGGTANTQ

SEQ ID NO: 2664 - protein, 2 aa, Parvovirus Adeno-associated virus
AN

SEQ ID NO: 2665 - protein, 8 aa, Parvovirus Adeno-associated virus
TGQNNNSN

SEQ ID NO: 2666 - protein, 7 aa, Parvovirus Adeno-associated virus
KDDEERF

SEQ ID NO: 2667 - protein, 6 aa, Parvovirus Adeno-associated virus
NAARDN

SEQ ID NO: 2668 - protein, 11 aa, Parvovirus Adeno-associated virus
NTAPQIGTVNS

SEQ ID NO: 2669 - protein, 2 aa, Parvovirus Adeno-associated virus
TS

SEQ ID NO: 2670 - protein, 7 aa, Parvovirus Adeno-associated virus
NTEGVYS

SEQ ID NO: 2671 - protein, 8 aa, Parvovirus Adeno-associated virus
NSTSGGSS

SEQ ID NO: 2672 - protein, 10 aa, Parvovirus Adeno-associated virus
VFMIPQYGYL

SEQ ID NO: 2673 - protein, 9 aa, Parvovirus Adeno-associated virus
INGSGQNQQ

SEQ ID NO: 2674 - protein, 2 aa, Parvovirus Adeno-associated virus
AV

SEQ ID NO: 2675 - protein, 8 aa, Parvovirus Adeno-associated virus
VTQNNNSE

SEQ ID NO: 2676 - protein, 7 aa, Parvovirus Adeno-associated virus
KEGEDRF

SEQ ID NO: 2677 - protein, 6 aa, Parvovirus Adeno-associated virus
GTGRDN

SEQ ID NO: 2678 - protein, 10 aa, Parvovirus Adeno-associated virus
QAQAQTGWVQ

SEQ ID NO: 2679 - protein, 2 aa, Parvovirus Adeno-associated virus
NN

SEQ ID NO: 2680 - protein, 7 aa, Parvovirus Adeno-associated virus
NTEGVYS

SEQ ID NO: 2681 - protein, 8 aa, Parvovirus Adeno-associated virus
NGTSGGST

SEQ ID NO: 2682 - protein, 10 aa, Parvovirus Adeno-associated virus
VFMVPQYGYL

SEQ ID NO: 2683 - protein, 9 aa, Parvovirus Adeno-associated virus
QTTGTGGTQ

SEQ ID NO: 2684 - protein, 2 aa, Parvovirus Adeno-associated virus
AN

SEQ ID NO: 2685 - protein, 8 aa, Parvovirus Adeno-associated virus
TNQNNNSN

SEQ ID NO: 2686 - protein, 7 aa, Parvovirus Adeno-associated virus
KDDDDRF

SEQ ID NO: 2687 - protein, 6 aa, Parvovirus Adeno-associated virus
GAGNDG

SEQ ID NO: 2688 - protein, 10 aa, Parvovirus Adeno-associated virus
NTQAQTGLVH

SEQ ID NO: 2689 - protein, 2 aa, Parvovirus Adeno-associated virus
TN

SEQ ID NO: 2690 - protein, 7 aa, Parvovirus Adeno-associated virus
NTEGVYS

SEQ ID NO: 2691 - protein, 8 aa, Parvovirus Adeno-associated virus
NGTSGGST

SEQ ID NO: 2692 - protein, 10 aa, Parvovirus Adeno-associated virus
VFMIPQYGYL

SEQ ID NO: 2693 - protein, 9 aa, Parvovirus Adeno-associated virus
STGGTAGTQ

SEQ ID NO: 2694 - protein, 2 aa, Parvovirus Adeno-associated virus
SA

SEQ ID NO: 2695 - protein, 8 aa, Parvovirus Adeno-associated virus
LSQNNNSN

SEQ ID NO: 2696 - protein, 7 aa, Parvovirus Adeno-associated virus
KDDEERF

SEQ ID NO: 2697 - protein, 6 aa, Parvovirus Adeno-associated virus
GAGKDN

SEQ ID NO: 2698 - protein, 10 aa, Parvovirus Adeno-associated virus
NAAPIVGAVN

SEQ ID NO: 2699 - protein, 2 aa, Parvovirus Adeno-associated virus
TN

SEQ ID NO: 2700 - protein, 7 aa, Parvovirus Adeno-associated virus
NTDGTYS

SEQ ID NO: 2701 - protein, 8 aa, Parvovirus Adeno-associated virus
NGTSGGST

SEQ ID NO: 2702 - protein, 10 aa, Parvovirus Adeno-associated virus
VFMIPQYGYL

SEQ ID NO: 2703 - protein, 9 aa, Parvovirus Adeno-associated virus
STGGTQGTQ

SEQ ID NO: 2704 - protein, 2 aa, Parvovirus Adeno-associated virus
SA

SEQ ID NO: 2705 - protein, 8 aa, Parvovirus Adeno-associated virus
LSQNNNSN

SEQ ID NO: 2706 - protein, 7 aa, Parvovirus Adeno-associated virus
KDDEERF

SEQ ID NO: 2707 - protein, 6 aa, Parvovirus Adeno-associated virus
GAGRDN

SEQ ID NO: 2708 - protein, 10 aa, Parvovirus Adeno-associated virus
NTGPIVGNVN

SEQ ID NO: 2709 - protein, 2 aa, Parvovirus Adeno-associated virus
TN

SEQ ID NO: 2710 - protein, 7 aa, Parvovirus Adeno-associated virus
NTEGTYS

SEQ ID NO: 2711 - protein, 8 aa, Parvovirus Adeno-associated virus
RLGTTSSS

SEQ ID NO: 2712 - protein, 10 aa, Parvovirus Adeno-associated virus
VFMVPQYGYC

SEQ ID NO: 2713 - protein, 9 aa, Parvovirus Adeno-associated virus
GETLNQGNA

SEQ ID NO: 2714 - protein, 2 aa, Parvovirus Adeno-associated virus
AF

SEQ ID NO: 2715 - protein, 12 aa, Parvovirus Adeno-associated virus
ASQNYKIPASGG

SEQ ID NO: 2716 - protein, 7 aa, Parvovirus Adeno-associated virus
GPSDGDF

SEQ ID NO: 2717 - protein, 6 aa, Parvovirus Adeno-associated virus
VTGNTT

SEQ ID NO: 2718 - protein, 10 aa, Parvovirus Adeno-associated virus
TTAPITGNVT

SEQ ID NO: 2719 - protein, 2 aa, Parvovirus Adeno-associated virus
SS

SEQ ID NO: 2720 - protein, 7 aa, Parvovirus Adeno-associated virus
DTTGKYT

SEQ ID NO: 2721 - protein, 8 aa, Parvovirus Adeno-associated virus
RIGTTANS

SEQ ID NO: 2722 - protein, 10 aa, Parvovirus Adeno-associated virus
VFMVPQYGYC

SEQ ID NO: 2723 - protein, 9 aa, Parvovirus Adeno-associated virus
GNSLNQGTA

SEQ ID NO: 2724 - protein, 2 aa, Parvovirus Adeno-associated virus
AY

SEQ ID NO: 2725 - protein, 12 aa, Parvovirus Adeno-associated virus
ANQNYKIPASGG

SEQ ID NO: 2726 - protein, 7 aa, Parvovirus Adeno-associated virus
GAGDSDF

SEQ ID NO: 2727 - protein, 6 aa, Parvovirus Adeno-associated virus
PSGNTT

SEQ ID NO: 2728 - protein, 10 aa, Parvovirus Adeno-associated virus
TTAPHIANLD

SEQ ID NO: 2729 - protein, 2 aa, Parvovirus Adeno-associated virus
NS

SEQ ID NO: 2730 - protein, 7 aa, Parvovirus Adeno-associated virus
DNAGNYH

SEQ ID NO: 2731 - protein, 8 aa, Parvovirus Adeno-associated virus
RLGTTSNS

SEQ ID NO: 2732 - protein, 10 aa, Parvovirus Adeno-associated virus
VFMVPQYGYC

SEQ ID NO: 2733 - protein, 9 aa, Parvovirus Adeno-associated virus
GETLNQGNA

SEQ ID NO: 2734 - protein, 2 aa, Parvovirus Adeno-associated virus
AF

SEQ ID NO: 2735 - protein, 12 aa, Parvovirus Adeno-associated virus
ASQNYKIPASGG

SEQ ID NO: 2736 - protein, 7 aa, Parvovirus Adeno-associated virus
GPSDGDF

SEQ ID NO: 2737 - protein, 6 aa, Parvovirus Adeno-associated virus
VTGNTT

SEQ ID NO: 2738 - protein, 10 aa, Parvovirus Adeno-associated virus
TTAPITGNVT

SEQ ID NO: 2739 - protein, 2 aa, Parvovirus Adeno-associated virus
SS

SEQ ID NO: 2740 - protein, 7 aa, Parvovirus Adeno-associated virus
DTTGKYT

SEQ ID NO: 2741 - protein, 8 aa, Parvovirus Adeno-associated virus
RLGSSNAS

SEQ ID NO: 2742 - protein, 10 aa, Parvovirus Adeno-associated virus
VFMVPQYGYC

SEQ ID NO: 2743 - protein, 9 aa, Parvovirus Adeno-associated virus
GGTLNQGNS

SEQ ID NO: 2744 - protein, 2 aa, Parvovirus Adeno-associated virus
SG

SEQ ID NO: 2745 - protein, 12 aa, Parvovirus Adeno-associated virus
ASQNYKIPQGRN

SEQ ID NO: 2746 - protein, 7 aa, Parvovirus Adeno-associated virus
ANDATDF

SEQ ID NO: 2747 - protein, 6 aa, Parvovirus Adeno-associated virus
ITGNTT

SEQ ID NO: 2748 - protein, 10 aa, Parvovirus Adeno-associated virus
TTVPTVDDVD

SEQ ID NO: 2749 - protein, 2 aa, Parvovirus Adeno-associated virus
DS

SEQ ID NO: 2750 - protein, 7 aa, Parvovirus Adeno-associated virus
DNAGAYK

SEQ ID NO: 2751 - protein, 8 aa, Parvovirus Adeno-associated virus
RIQGPSGG

SEQ ID NO: 2752 - protein, 10 aa, Parvovirus Adeno-associated virus
IYTIPQYGYC

SEQ ID NO: 2753 - protein, 9 aa, Parvovirus Adeno-associated virus
VSQAGSSGR

SEQ ID NO: 2754 - protein, 2 aa, Parvovirus Adeno-associated virus
AA

SEQ ID NO: 2755 - protein, 12 aa, Parvovirus Adeno-associated virus
ASNITKNNVFSV

SEQ ID NO: 2756 - protein, 7 aa, Parvovirus Adeno-associated virus
FSGEPDR

SEQ ID NO: 2757 - protein, 8 aa, Parvovirus Adeno-associated virus
VYDQTTAT

SEQ ID NO: 2758 - protein, 10 aa, Parvovirus Adeno-associated virus
VTPGTRAAVN

SEQ ID NO: 2759 - protein, 2 aa, Parvovirus Adeno-associated virus
AD

SEQ ID NO: 2760 - protein, 7 aa, Parvovirus Adeno-associated virus
SDTGSYS

SEQ ID NO: 2761 - protein, 8 aa, Artificial sequence
  AAV capsid amino acid substitution
SENVQTEN

SEQ ID NO: 2762 - protein, 730 aa, Artificial sequence; identical to SEQ ID NO: 179
  Recombinant AAV capsid

SEQ ID NO: 2763 - protein, 736 aa, Artificial sequence
  Recombinant AAV capsid
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTSENVQTENQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSSKVESWTEWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 2764 - protein, 8 aa, Artificial Sequence
  AAV capsid amino acid substitution
  MISC_FEATURE (1)..(1): Xaa can be any amino acid except A
  MISC_FEATURE (2)..(2): Xaa can be any amino acid except Q
  MISC_FEATURE (3)..(3): Xaa can be any amino acid except A
  MISC_FEATURE (4)..(4): Xaa can be any amino acid except Q
  MISC_FEATURE (5)..(5): Xaa can be any amino acid except A
  MISC_FEATURE (6)..(6): Xaa can be any amino acid except Q
  MISC_FEATURE (7)..(7): Xaa can be any amino acid except T
  MISC_FEATURE (8)..(8): Xaa can be any amino acid except G
XXXXXXXX

SEQ ID NO: 2765 - protein, 8 aa, Artificial Sequence
  AAV capsid amino acid substitution
  MISC_FEATURE (1)..(1): Xaa can be any amino acid except A
  MISC_FEATURE (2)..(2): Xaa can be any amino acid except Q
  MISC_FEATURE (3)..(3): Xaa can be any amino acid
  MISC_FEATURE (4)..(4): Xaa can be any amino acid except Q
  MISC_FEATURE (5)..(5): Xaa can be any amino acid
  MISC_FEATURE (6)..(6): Xaa can be any amino acid except Q
  MISC_FEATURE (7)..(7): Xaa can be any amino acid
  MISC_FEATURE (8)..(8): Xaa can be any amino acid except G
XXXXXXXX

SEQ ID NO: 2766 - protein, 8 aa, Artificial Sequence
  AAV capsid amino acid substitution
  MISC_FEATURE (1)..(1): Xaa is T, M, S, or R
  MISC_FEATURE (2)..(8): Xaa can be any amino acid
XXXXXXXX

SEQ ID NO: 2767 - protein, 8 aa, Artificial Sequence
  AAV capsid amino acid substitution
  MISC_FEATURE (1)..(1): Xaa can be any amino acid
  MISC_FEATURE (2)..(2): Xaa is I, S, K, T, or D
  MISC_FEATURE (3)..(8): Xaa can be any amino acid
XXXXXXXX

SEQ ID NO: 2768 - protein, 8 aa, Artificial Sequence
  AAV capsid amino acid substitution
  MISC_FEATURE (1)..(2): Xaa can be any amino acid
  MISC_FEATURE (3)..(3): Xaa is D, A, V, or Y
  MISC_FEATURE (4)..(8): Xaa can be any amino acid
XXXXXXXX

SEQ ID NO: 2769 - protein, 8 aa, Artificial Sequence
  AAV capsid amino acid substitution
  MISC_FEATURE (1)..(3): Xaa can be any amino acid
  MISC_FEATURE (4)..(4): Xaa is D or E
  MISC_FEATURE (5)..(8): Xaa can be any amino acid
XXXXXXXX

SEQ ID NO: 2770 - protein, 8 aa, Artificial Sequence
  AAV capsid amino acid substitution
  MISC_FEATURE (1)..(4): Xaa can be any amino acid
  MISC_FEATURE (5)..(5): Xaa can be S, P, or A
  MISC_FEATURE (6)..(8): Xaa can be any amino acid
XXXXXXXX

SEQ ID NO: 2771 - protein, 8 aa, Artificial Sequence
  AAV capsid amino acid substitution
  MISC_FEATURE (1)..(5): Xaa can be any amino acid
  MISC_FEATURE (6)..(6): Xaa is L, I , or W
  MISC_FEATURE (7)..(8): Xaa can be any amino acid
XXXXXXXX

SEQ ID NO: 2772 - protein, 8 aa, Artificial Sequence
  AAV capsid amino acid substitution
  MISC_FEATURE (1)..(7): Xaa can be any amino acid
  MISC_FEATURE (8)..(8): Xaa is Y, I, E, or Q
XXXXXXXX
